United States Patent 7,842,466 (COLON DISEASE TARGETS AND USES THEREOF) - sequence listing, part 2

SEQ ID NO: 2125 - DNA, 9448 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattc

SEQ ID NO: 2126 - DNA, 2949 bp, Homo sapiens
cagtcggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcaagcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattga

SEQ ID NO: 2127 - DNA, 3083 bp, Homo sapiens
cagtcggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccatcgtcaatctgccaggctgcagtgccaaagagctggccccggctgtgtcagtgctccagcttttctgcagctcacccaaggctgctctccgctatgctgctgttcgtaccctcaataaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgacttttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaatga

SEQ ID NO: 2128 - DNA, 2178 bp, Homo sapiens
catgcgttctccgaacggtcttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacg

SEQ ID NO: 2129 - DNA, 2134 bp, Homo sapiens
ttccgacagcttgctgccctagaccagagttggtggctggacctcctgcgacttccgagttgcgatgctgtacttctctttgttttgggcggctcggctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacg

SEQ ID NO: 2130 - DNA, 2113 bp, Homo sapiens
ccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgaaaaaaaaaaaaaaaaaa

SEQ ID NO: 2131 - DNA, 2178 bp, Homo sapiens; identical to SEQ ID NO: 2128

SEQ ID NO: 2132 - DNA, 2809 bp, Homo sapiens
catgcgttctccgaacggtcttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacgtgagtgctctaggtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatccctttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagaccccagccttaacttctcgacagttccgtgaggatgacttccggagagttgtggactttatagatgaaggggtcaacattggcttagaggtgaagagcaagatctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcc

SEQ ID NO: 2133 - DNA, 2178 bp, Homo sapiens; identical to SEQ ID NO: 2128

SEQ ID NO: 2134 - DNA, 2178 bp, Homo sapiens; identical to SEQ ID NO: 2128

SEQ ID NO: 2135 - DNA, 5191 bp, Homo sapiens; identical to SEQ ID NO: 1801

SEQ ID NO: 2136 - DNA, 1515 bp, Homo sapiens; identical to SEQ ID NO: 1839

SEQ ID NO: 2137 - DNA, 5508 bp, Homo sapiens
cgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaaggtaaattacttatagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcaaatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaatttttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattc

SEQ ID NO: 2138 - DNA, 6907 bp, Homo sapiens
ggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagagcgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagt

SEQ ID NO: 2139 - DNA, 6928 bp, Homo sapiens
ggcgggagcgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaacataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcagtgatcctcccgcctcggcctcccaaagtgctgggattacaggcatgagccaccgcgcctggcctctgcttactttttatatagcaaaatgattccccttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacggctgtatataatggtgatgtcataataaagttgttttatcttttaagtaaaaaaaaaaaaaaaaaaaaa

SEQ ID NO: 2140 - DNA, 5794 bp, Homo sapiens
gcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatggttcctgaaggtcattagagtgtgtgtgtgtgtgtgtgtgtgtgtgtgtgttt

SEQ ID NO: 2141 - DNA, 5794 bp, Homo sapiens; identical to SEQ ID NO: 2140

SEQ ID NO: 2142 - DNA, 5765 bp, Homo sapiens
gcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgtttttttttttttgtatattgatgaatgagatcttacctattaaatatattattggattatggttcctgaaggtcattagagtgtgtgtgtgtgtgtgtgtgtgtgtgtgtgttt

SEQ ID NO: 2143 - DNA, 2436 bp, Homo sapiens
cccagtcgcgccgccagcgggctgagggtaggaagtagccgctccgagtggaggcgactgggggctgaagagcgcgccgccctctcgtcccattttgtaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagcaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggttctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatattttgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctg

SEQ ID NO: 2144 - DNA, 2436 bp, Homo sapiens
cccagtcgcgccgccagcgggctgagggtaggaagtagccgctccgagtggaggcgactgggggctgaagagcgcgccgccctctcgtcccattttgtaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggttctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatattttgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctg

SEQ ID NO: 2145 - DNA, 2436 bp, Homo sapiens; identical to SEQ ID NO: 2143

SEQ ID NO: 2146 - DNA, 2769 bp, Homo sapiens
ggcccagtcgcgccgccagcgggctgagggtaggaagtacccgctctgagtggaggcgactggggactgaagagcgcgcagccctctcgtcccactttccaggtgtgtgatcctgtaaaattaagtcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacagctgaggactgctttgagttgggcaaagtggcctatacagaagcagattattaccatacagaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaattgtcaaagacctagcaaaaccaaggctgaggcgagccaccatttcaaacccaataacaggagacttggagacggtacattacagaattagcaaaagtgcctggctctctggctatgaaaaccctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgcaccttgtcagaattggaatgacaaacaggcttccctttctctcctattgttgtactcttatgtgtctgatacacacatttcctagtcttaactttcaggagtttacagttgactaacactccatgattgattcagtcatgaacctcatgccatgtttcatctgtggacaatcgtttactttatgggttattttaaaagtaacatgaaatcaccatattgcgtatgtaaaaccttaaagttctgttggtatcacagaagataaggcagagtttaaagtgaggaattttatatttaaagaactttttggttggataaaaacataatttgagcatccaattttagtatttcactacatctcagttggtgggtgttaagctagaatgggccgtgtgataggaaacaaatgccttacagatgtgtctaggtgttctgtttacctagtgtcttactctgttttctggatctgaagactagtaataaactaggacactaactgggttccatgtgatccatgtgatgtttgccctttcatatgatctcctaagttgattttttttcctcccaagtcctttttaaagaaagtatagtgtattttaccaaccccctctcttttctcttagctcttctgtggtgaattaaacctacttgagttaaaatatttctttttttttttttttaacagaaagtcctgcataacaacactgggccttcttaactaaaatgctcaccacttagtctgttttttaatcccttttttaaaatgacagatgattttgtccagaaattttgctgtttttcttagtgctaataccttgcctcttattcctgctacagcagggtggtaatattggcattctgattaaatactgtgccttaggagactggaagtttaaaaatgtagaagtcctttcagtgatgagggaattgattttttttttaaagtctttttcttagaaagccaaaatgtttgtttttttaaaattctgaaatgtgtgtgacaacaatgacctatttatgatcttaaatcttttttaaaaaaaaaaaaaaaaaa

SEQ ID NO: 2147 - DNA, 2436 bp, Homo sapiens; identical to SEQ ID NO: 2144

SEQ ID NO: 2148 - DNA, 16382 bp, Homo sapiens; identical to SEQ ID NO: 1612

SEQ ID NO: 2149 - DNA, 3147 bp, Homo sapiens
catcggtgttcgctgatgtccagtctatggagtcagttggtaccggtggcggcgcggaggcagaaggcggtgtccgagtaggggcctctgccccaccaggatgttaccggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctacctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgtaggtgcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaacctactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtgaaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaaaaaaaaaaaaa

SEQ ID NO: 2150 - DNA, 2482 bp, Homo sapiens
tgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcatt

SEQ ID NO: 2151 - DNA, 1112 bp, Homo sapiens
tgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccgtacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaa

SEQ ID NO: 2152 - DNA, 4502 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaaggtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacatt

SEQ ID NO: 2153 - DNA, 2236 bp, Homo sapiens
ctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataaaaaaaaaaaaaaaaaaaaaaaaa

SEQ ID NO: 2154 - DNA, 4502 bp, Homo sapiens; identical to SEQ ID NO: 2152

SEQ ID NO: 2155 - DNA, 2475 bp, Homo sapiens
ccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtgaaaaaaaaaaaaaaaa

SEQ ID NO: 2156 - DNA, 5623 bp, Homo sapiens
gaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggacagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagcatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaaaaaaaaaa

SEQ ID NO: 2157 - DNA, 2809 bp, Homo sapiens; identical to SEQ ID NO: 2132

SEQ ID NO: 2158 - DNA, 4240 bp, Homo sapiens
ctttggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggcacggactgctcacattctgaggtgtcagggatggggaggagggagaccggctggtgggtgcatgggctatggtcactgtgggcacccctgcaggagtcccatagccagagtgcccagggctcaaggctcgcatcagcaagtgctcaggctt

SEQ ID NO: 2159 - DNA, 4125 bp, Homo sapiens
cggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggcaaaaaaaaaaaaaaaaaaaaaaaaaaaaaaaaaaaaaaaaaaaaa

SEQ ID NO: 2160 - DNA, 2235 bp, Homo sapiens
gggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtcggtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaaaaaaaaaaaaaaaaaa

SEQ ID NO: 2161 - DNA, 3786 bp, Homo sapiens
gtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaacacgtgccgccctaaggccaaggcggagctggctgctgtcgcttctgcccacattccatgggtgctgtcgagctgtaggtccaagccccacatcaggggagtgagtggggtacaatcctcccatgctgggccccactctggagataggcctggggaatgcccaagaaggaagcccagcccttctgggattttcacatccacagagaatgggtgctggcagccaacggcaacgaggagaaaagctgaccgccttctcagatcaggatgaggtgtttttacaccaaccccgaggatctgcagccttctcaggttaaattaaacctgtcacagacacaggaagggaaaagagcacataacaacaattatattgacatctaagccaggtcacatgctctgatttggctgaaattacaggataaaggaaaaatcctataggcaccatggctggaaacaaatggcctcaaaggaacgctggtggccgtggctttgtgcaacgacagccagtgttgtgtgacccagcgacgtgcaggccagggagggtacccttctactgatcaagagggaaagcgggaaggacgcacagctgtggtttccaacctgcacggaggcacccccatgaactcacagagcaccatcagatccttctgaattttgaaggaagcaatgatactctgctctgctcaaggccattcatggtctcaacattaacgttaccttgctttatagggtatcttccctctctctgccaggctgggttgtggcagtcactgaacaagcaattactgtgaaggtcgacgtggaaaaatgaggcaatgagggtggcggtgttctaccagattccaagttgaagaggtgctcgacaggcacacacatcccatgactaaacaaataacatgaacatttctctttatgtattacttttctagacatccactataagttgccaggacacaaatgcttattattggggtttacttatttaataaatggaactgtggggg

SEQ ID NO: 2162 - DNA, 3786 bp, Homo sapiens; identical to SEQ ID NO: 2161

SEQ ID NO: 2163 - DNA, 3786 bp, Homo sapiens; identical to SEQ ID NO: 2161

SEQ ID NO: 2164 - DNA, 3786 bp, Homo sapiens; identical to SEQ ID NO: 2161

SEQ ID NO: 2165 - DNA, 3786 bp, Homo sapiens; identical to SEQ ID NO: 2161

SEQ ID NO: 2166 - DNA, 2589 bp, Homo sapiens
cgcccgcagagccgccccaggtgcctgggtgttgtgtgattgacgcggggaaggaggggtcagccgatccctccccaaccctccatcccatccctgaggattgggctggtacccgcgtctctcggacagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 2167 - DNA, 2589 bp, Homo sapiens; identical to SEQ ID NO: 2166

SEQ ID NO: 2168 - DNA, 2589 bp, Homo sapiens; identical to SEQ ID NO: 2166

SEQ ID NO: 2169 - DNA, 1575 bp, Homo sapiens
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 2170 - DNA, 2366 bp, Homo sapiens; identical to SEQ ID NO: 1542

SEQ ID NO: 2171 - DNA, 1592 bp, Homo sapiens
agcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaagtttttgtatgaatatgcaagaaggcatcctgattactctgtctgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagtt

SEQ ID NO: 2172 - DNA, 2106 bp, Homo sapiens; identical to SEQ ID NO: 1734

SEQ ID NO: 2173 - DNA, 4103 bp, Homo sapiens
ctcacagcccgaaactgcaaggagctcctctgcccggcctctctttactcctcctctctgcccctcagctcgctcatctttcttcccgccccctctcttttccttctttggttctttgaagtgatgagctagcgcaaccacaaaccatacattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacgcggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaaggcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataa

SEQ ID NO: 2174 - DNA, 4103 bp, Homo sapiens; identical to SEQ ID NO: 2173

SEQ ID NO: 2175 - DNA, 5998 bp, Homo sapiens
agcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacag

SEQ ID NO: 2176 - DNA, 7448 bp, Homo sapiens
cgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggcgctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacatggcccgggcccaggcagagagccaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatacttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagcc

SEQ ID NO: 2177 - DNA, 7448 bp, Homo sapiens; identical to SEQ ID NO: 2176

SEQ ID NO: 2178 - DNA, 1309 bp, Homo sapiens
cctcctctccgcgcggggcgggctccgcgccacgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcac

SEQ ID NO: 2179 - DNA, 2063 bp, Homo sapiens
aaactttactttttgtggagatgagtcctgctgtgttgtgtaggctggtcttgaactcctggcctcacgcaatccacccccaaccttggcctcccggagtgcagggattacaggtgtgagccacctttcccagcctgttgactcctttaattcagaggagtcagtcagattttagacatctcaaatgttgtatgttcaaaaccaaactcctggtcttttccccaaacttgtgtctccctgtcttgcccaatcagctgttgacacctccaatccttgcagttgctgcggccaaaactcagtcatccctcactcctttactgctctcaaacccacatccagcctagaaatgccatcccctccaccttcaaaatgcatccagaccccgccctttcttcgacacttggctgaccacaccctggtcctgtccacccttggctcctgtctggatgctcccagcagcctcctccctgggctcccttgccctgccccagtctgttccccacgcacagccgccaggggatcctgtaacacctgtgtttgtttcttcgggctgctgtaacaaattgccaccaagttggtggcttaacacaacagaatgtatggccaggcgcagtggctcctgcctgtaatcccagcactttgggaggccgagacagtcgatcatttgaagttgcaccactgcactccagcctggataacagagcgagactccgtcttaaaaaaaaaaaaaaaaaaaaaagacaacaaattcattctctcagttttggagccgaagtccaaactcaaggtgtagcagggccatgcgcctccagaagctggaggggagattccattcctcacctctcccagcttctagtggctccaggcattgctgggtttatggccacatcaccctaatgtcagcctccctgttcacatgaccttctgcctgttctatctctgaggacagttgtgattggatttagggcccatccagttagtccaggatgatctcatctcaagatcctaagtctgattacaattgcaaagatcctttttccaaataaggtcacatgcacgtaagttccggggattatgcttgcgtgggacacattttttttgaggccaccattcaacccactacaaaatccaactgaagcccagcgaagtggctcatgcctgaaatccccgcactgtgcgaggccaaggcgggagggtcacctgaggccaggagttcaagagtagcctgggcagcgtagggagatcctcatctcttttttttttcgagatggagtttcgttcttgttgctcaggctggagtgcaatggcgcaatcttggctcactatgacttcctcctcctgggttcgagcgattctcctgcctcagcaatcccgagtagctgggattacaggcatgtgccaccatgcccgtctctattaaggatgcaaaattggccaggcatggtggcacatgcctgtggtcccagctactcgggaggctgagacaggagaatcgttcgaatctgggaggcggaggttgcagtgggcctagatcgtgccattgcactgtagcctgggcaacaagagcgagactccgtctcaaaaaaaaaaaaaaaaaaaaaaactgcatgatcttgggcaactaacttaacctcccagcgcctcagttactgcatctgcaatatgggaatgaaaacacaaattaatcattctgcacataattcttaagcatgtactatatatgtgcccaacactgctagacactggggatacctcaatgaacaatacagacaaaaatatctcggcctggcgcagtggctcacgcctgtaatccaagcactttgggaggtgaagtgggtggatcgcctgagaccaggagtttgagaccagcctggacaacatggtgaagccccatctctactaaaggtgcaaaaattagccaggcatggtggcgcgcccctaaaatctgagcaactcgggaggctgaggtgagaggattgcttgagcccgggaggcggaggctgcagtgagttgagatcgcgccactgcactccagcctgggtgacagagtgagaccccatctc

SEQ ID NO: 2180 - DNA, 9962 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagttaaaaaaaaaaaaaaaaaa

SEQ ID NO: 2181 - DNA, 9959 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagttaaaaaaaaaaaaaaaaaa

SEQ ID NO: 2182 - DNA, 10562 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagttaaaaaaaaaaaaaaaaaa

SEQ ID NO: 2183 - DNA, 9944 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagttaaaaaaaaaaaaaaaaaa

SEQ ID NO: 2184 - DNA, 10061 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagttaaaaaaaaaaaaaaaaaa

SEQ ID NO: 2185 - DNA, 6936 bp, Homo sapiens; identical to SEQ ID NO: 1676

SEQ ID NO: 2186 - DNA, 1376 bp, Homo sapiens
cagtgcctgaaatccagcctgctgcttactcacatcctcatactcagctgcagactgcctgacagaagggctgccaaactgcactccagacagacaggtgcacagccaggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaa

SEQ ID NO: 2187 - DNA, 1676 bp, Homo sapiens
agcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaa

SEQ ID NO: 2188 - DNA, 2005 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacaccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaag

SEQ ID NO: 2189 - DNA, 2823 bp, Homo sapiens
gaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaagtgggtaaccaacagcttggaggacccgagtggattcgattctctctcactcctcggccactcaactgctccttgtccctgactccgcgagggcaaagatgggtcagggtgggatgttacattagtgttgagactctttggatccgtttcgtgggtaccgaggacgcctgggtacgcgggacaggctgcacccgcctgctagaggcgccccatcgaggcgccacgggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattgg

SEQ ID NO: 2190 - DNA, 2823 bp, Homo sapiens; identical to SEQ ID NO: 2189

SEQ ID NO: 2191 - DNA, 2503 bp, Homo sapiens
ggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaaaagcttgtcttcgtccatctgttgacaaatgacagacctttttttttcccccatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactgtacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaagagtgccagtcagcagtcatgca

SEQ ID NO: 2192 - DNA, 2328 bp, Homo sapiens
ctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatctttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaaaaaaaaaaaaaaaaaaaaaaaaaaaaa

SEQ ID NO: 2193 - DNA, 2390 bp, Homo sapiens
tgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtatttcccgtcagtgataatcaggtacagaggtgcagttccatggtacaccataaatcttgacttaccaccctacaaaagatggcatgaattgatgcttgacaaggcaccaatgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttaattctcataagtagcattcatgtaataaacaggtttttagtttgttcttcagattgatagggagttttaaagaaattttagtagttactaaaattatgttactgtatttttcagaaatccaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattgg

SEQ ID NO: 2194 - DNA, 2823 bp, Homo sapiens; identical to SEQ ID NO: 2189

SEQ ID NO: 2195 - DNA, 1770 bp, Homo sapiens; identical to SEQ ID NO: 1845

SEQ ID NO: 2196 - DNA, 2823 bp, Homo sapiens
ggcggggttagcgcctgcgctctggacggctttggggcagggcagatttatatctgcgggggatcagctgacgctccgcattgcagactgcggagtcagacggtgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgaagtgtgcaagaagctggtgggttatttggatcgcaacctggagaaaaacagcaccaagcaggagatcctggctgctcttgagaaaggctgcagcttcctgccagacccttaccagaagcagtgtgatcagtttgtggcagagtacgagcccgtgctgatcgagatcctggtggaggtgatggatccttccttcgtgtgcttgaaaattggagcctgcccctcggcccataagcccttgttgggaactgagaagtgtatatggggcccaagctactggtgccagaacacagagacagcagcccagtgcaatgctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagcca

SEQ ID NO: 2197 - DNA, 1393 bp, Homo sapiens
gcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtgaaaaaaaaaaaaaaaaaaaaaa

SEQ ID NO: 2198 - DNA, 3615 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatgacctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatgga

SEQ ID NO: 2199 - DNA, 2144 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggttaaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaacatagattgagaacagttgaactcttaaatcctcagatgccaggggtctgctctagcatcaacgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggatggctctgggaagtcaccgctgggcatggctgtgtcactagggctttgtggctgatgaataacagctgtcgtgtgctgtttctgggtggagatgtcccaggaaaccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggc

SEQ ID NO: 2200 - DNA, 3521 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatgacctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatgga

SEQ ID NO: 2201 - DNA, 1881 bp, Homo sapiens
ggcgcgacgcgccaccaccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggactctcttctctgacctgagtctcctttggaactctgcagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtga

SEQ ID NO: 2202 - DNA, 1895 bp, Homo sapiens
tgagctcttccacccagcgtgcacttgcctcccccctgcctccaggtgcggcaccacctcctctctctcttaagggtttaaacttgccacttcaaagttcgccatggatgatgatattgctgctctcgtggtcgacaatggctccggaatgtgcaaagctggttttgcaggagacgatgcccctcgggccgtcttcccttccattgttgggcgccccagacatcagggtgtgatggtgggtatgggccagaaagacagctacgtgggggatgaggcccagagcaagagaggtattctgaccctgaagtaccccattgaacacggtattgtcaccaactgggatgacatggagaagatctggcatcatactttctacaatgagctccgtgtggcccctgaagagcaccctgtgctgctgacagaagcccccctgaaccccaaagccaacagagaaaagatgactcagattatgtttgagaccttcaacaccccagccatgtacgttgccatccaggctgtgctgtccctgtatgcctctggtcgtaccactggtattgtgatggactccggtgatggtgtgacccacactgtgcccatctatgaaggttatgcccttccccatgccatcctccgtctggatctggctggccgtgatctgacggactacctcatgaagatcctgaccgagagagggtacagtttcactaccacagctgagagggaaatcgtgcgtgacatcaaggagaagctgtgttacgtcgccctagacttcgagcaggagatggccactgctgcatctagctcttctctggaaaagagctacgagctccctgatggtcaggtcatcaccattggcaacgagaggttccgatgcccagaagccctcttccaaccatctttcttaggtatggaatcctgtggaatccacgaaactaccttcaactcaatcatgaagtgtgatgttgacatccgtaaggatttgtatgccaataccgtattgtctggtggtaccaccatgtacccaggcattgctgacaggatgcagaaggagattacagccctagctcccagcacaatgaaaatcaagatcattgccccacctgagcgtaaatactctgtctggattggaggctccatcctggcctctctttccaccttccagcagatgtggatcagcaagcaggagtatgatgaatctgggccctccattgtccaccgcaaatgcttctaaatggactgtttgtgtttttttgatttttttttttttttttttgtcaaagggtgtgacatgataattgcccaaaaaaagagatgagattggcatggctttatttgtttttttttttgttttggtttttttttttttttttttttggcgcttgactcaggatttaaaaactggaacggtgaaggtgatgagcagtctaatgtgttggaggcaaacatccccaaagttctacagtgcgtcttcaggactcagattgtacatttgttttgtttttttaatagtcattccaaatattgtataatgcattgttacagagttacaagcctctgtgaaggctgtcctttgctagagcaaaggagctatgtaacaaaaatccagtgggggaggggggaggggggaaggtactagtattgctttacatgtaaattatgtaatcctttaaaaaacaaaaaaactttttgtatcttccgccttaatacttgttccttttttttttttttaaattgtcagccataatgaatggccccctaaattccctccctgcccccaacatagatgtgaatgaagactttacagtctccctgcgagttttttgagattggtgccagtacttgggggaggggaggagctttacctgtacactgacttaagaccagttcaaataaaa

SEQ ID NO: 2203 - DNA, 1840 bp, Homo sapiens
ggcgcgacgcgccaccaccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtga

SEQ ID NO: 2204 - DNA, 1840 bp, Homo sapiens; identical to SEQ ID NO: 2203

SEQ ID NO: 2205 - DNA, 1207 bp, Homo sapiens
atgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacggcctctggttaaatccctcccctcctgcttggcaacttcagctagctagatatatccatggtccagaaagcaaacataataaatttttatcttgaagt

SEQ ID NO: 2206 - DNA, 778 bp, Homo sapiens
cccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagc

SEQ ID NO: 2207 - DNA, 1194 bp, Homo sapiens
acaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaa

SEQ ID NO: 2208 - DNA, 778 bp, Homo sapiens; identical to SEQ ID NO: 2206

SEQ ID NO: 2209 - DNA, 1294 bp, Homo sapiens
gtaagaaacggttgaactggatgcaatttttatcacagcttgtgtaagactgcctctgtccctcctctcacatgccattggttaaccagcagacagtgtgctcaggggcgttgcagctcattgctcttatagcctgtgagggcacggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 2210 - DNA, 2532 bp, Homo sapiens
cgctgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactcagcactgcccctcctcctc

SEQ ID NO: 2211 - DNA, 2494 bp, Homo sapiens
gcagatggccgggtttagagctgtacgaagacacacagctaatgaaaaattgtggaattctcagagcccgtgaagcctagcccacggatgcgaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactcagcactgcccctcctcctc

SEQ ID NO: 2212 - DNA, 2364 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaactttt

SEQ ID NO: 2213 - DNA, 2364 bp, Homo sapiens; identical to SEQ ID NO: 2212

SEQ ID NO: 2214 - DNA, 4058 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggcaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaaggctggtctcgaactcctggcctcaagtgatcctcccgcctcggtctcccaaagtgctgggattacaggtgtgagccattgtaccctgccaataattgtgtatatgtacgggatataatgtgatgttctgatctatgtatagataaagattaaa

SEQ ID NO: 2215 - DNA, 1651 bp, Homo sapiens
gcctgggtcctagggaaggaagccatgctggggtaccaggactacaagactgccatgctgtcggacatcaaagccctcattctcaagcacgaggccttcgagagctacctggctgcggcacaccagcaccgcgtggagcagatcgcagcctttgcccaggagctcaacgagctggattactatgactcccacaatgtccacacccggtgccagaagatctgggaccagtgggacgccctcggctctctgaccaacagtcgcagggaagccctggagaaaacagagaagcagctggaggccatagaccatctgcacctggagtatgccaagcgcgtggcccccttcaacaactggatggagagcgccatggaggacctccaggacatgttcatcatctacaccatcgaggacactgagggcctgatctcagcccacgaccagttcaagtccaccctgccggacgctgacagggagcacgaggccatcctggccatccacaaggaggcccagaggatcgctgagcgcaaccacatcaagctgtcaggcagcaacccctacaccaccgtcaccccacagatcatcaactccaagtgggggaaggtgcagcagctggtgccaaaacgggaccacgccctcctggaggagcagagcaaccagcagtccaacaagcacctgcgctgccagttcgccagccaggccaacgtcgtggggccctggatccagaccaagatggaggagatcgggctcatctccactgagatgaacgggaccctggaggaccagctgagccacctgaagcagtgtgaaaacagcatcgtggactacaagcctaacctggacctgctggagcagcagcaccagctcatccaggaggccctcatcttcgacaacaagcacaccatggagcacatccgcgtgggcagggagcagctgctcaccaccattgccccaaccatcatcgaggtggagaaccagatcctcacccgcgacgtcaaaggcatcagccaggagcagatgcagcagttccgggcgtccttcaaccacttcgacaaggatcatggtggggtgctggggcctgaggggttcaaggcctgcctcatcagcctgggctatgacgtggagaacgaccggcagggtgaggccgagttcaaccgcatcatgagcctggtcgaccccaaccatagcggccttgtgaccttccaagccttcatcgacttcatgtcgcaggagaccaccgacacggacatggccgaccaggtcatcgcctccttcaaggtcctggcaagggacaagaacttcatcacagctgaggagctgcgagagagctgctccccgaccaggccgagtactctattgcccgcatggtgccctaccagggccctgacgccgtgcccggtgtcctcgactacaagtcttcctccacagccctgtatggcgagagcgacctgtgaggccccagagagacccggacccaacaccccctatggcctccaggaggggccggggcagccccacagtcccgttcctccactctgtatctatgcaaagcactctctgctgtcctcccgggtggctgggtgggcagggaggggctggggcaggctctctcctgtctctttttgggagttggccaggaggttcccccgaccag

SEQ ID NO: 2216 - DNA, 1931 bp, Homo sapiens
actggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctcttccttggccagaagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttaaaaaaaaaaaaaaaa

SEQ ID NO: 2217 - DNA, 779 bp, Homo sapiens
cccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgaccccacgg

SEQ ID NO: 2218 - DNA, 1956 bp, Homo sapiens
gaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttg

SEQ ID NO: 2219 - DNA, 1935 bp, Homo sapiens
ctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaggagttcatttcgcatactgggcattaaaataaaaatttgaacaatgaaaggaaaaaaaggagaaaaaaaaaa

SEQ ID NO: 2220 - DNA, 1956 bp, Homo sapiens; identical to SEQ ID NO: 2218

SEQ ID NO: 2221 - DNA, 2161 bp, Homo sapiens
ggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatc

SEQ ID NO: 2222 - DNA, 2023 bp, Homo sapiens
ggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatc

SEQ ID NO: 2223 - DNA, 2083 bp, Homo sapiens
ggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaaaaaaaaaaaaaaaaaaaaaaaaaaaaaaaaaaa

SEQ ID NO: 2224 - DNA, 2221 bp, Homo sapiens
ggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaaaaaaaaaaaaaaaaaaaaaaaaaaaaaaaaaaa

SEQ ID NO: 2225 - DNA, 2074 bp, Homo sapiens
ggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatct

SEQ ID NO: 2226 - DNA, 2083 bp, Homo sapiens
ggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaaggtagatttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtaagtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatct

SEQ ID NO: 2227 - DNA, 2161 bp, Homo sapiens; identical to SEQ ID NO: 2221

SEQ ID NO: 2228 - protein, 11 aa, Homo sapiens
IVNETLYENTK

SEQ ID NO: 2229 - protein, 12 aa, Homo sapiens
CNEPAVWSQLAK

SEQ ID NO: 2230 - protein, 12 aa, Homo sapiens
AFSTLLVNVSGK

SEQ ID NO: 2231 - protein, 18 aa, Homo sapiens
KFLDGNELTLADCNLLPK

SEQ ID NO: 2232 - protein, 15 aa, Homo sapiens
TVIRPFYLTNSSGVD

SEQ ID NO: 2233 - protein, 13 aa, Homo sapiens
CHIDLSGIVEEVK

SEQ ID NO: 2234 - protein, 19 aa, Homo sapiens
AAPLDSIHSLAAYYIDCIR

SEQ ID NO: 2235 - protein, 18 aa, Homo sapiens
QKNSSDIVQIAPQSLILK

SEQ ID NO: 2236 - protein, 10 aa, Homo sapiens
LDFVCSFLQK

SEQ ID NO: 2237 - protein, 9 aa, Homo sapiens
ESNCYDPER

SEQ ID NO: 2238 - protein, 15 aa, Homo sapiens
SVLDAAQIVGLNCLR

SEQ ID NO: 2239 - protein, 20 aa, Homo sapiens
DQELYFFHELSPGSCFFLPK

SEQ ID NO: 2240 - protein, 14 aa, Homo sapiens
KNILEESLCELVAK

SEQ ID NO: 2241 - protein, 23 aa, Homo sapiens
IIEGEPNLKVPGNVTAVLGETLK

SEQ ID NO: 2242 - protein, 17 aa, Homo sapiens
AAVEEGIVLGGGCALLR

SEQ ID NO: 2243 - protein, 24 aa, Homo sapiens
TTVTGDKDSVNLTCSTNDTGISIR

SEQ ID NO: 2244 - protein, 21 aa, Homo sapiens
CESAPGCGVWQRPVIDNPNYK

SEQ ID NO: 2245 - protein, 12 aa, Homo sapiens
AVLVNNITTGER

SEQ ID NO: 2246 - protein, 15 aa, Homo sapiens
ICDQWDALGSLTHSR

SEQ ID NO: 2247 - protein, 8 aa, Homo sapiens
CKPPPDIR

SEQ ID NO: 2248 - protein, 13 aa, Homo sapiens
LCLISTFLEDGIR

SEQ ID NO: 2249 - protein, 13 aa, Homo sapiens
ALGFENATQALGR

SEQ ID NO: 2250 - protein, 29 aa, Homo sapiens
SGTIFDNFLITNDEAYAEEFGNETWGVTK

SEQ ID NO: 2251 - protein, 19 aa, Homo sapiens
FVPYLIAGIQHSCQDIGAK

SEQ ID NO: 2252 - protein, 10 aa, Homo sapiens
WACLVAGGSK

SEQ ID NO: 2253 - protein, 32 aa, Homo sapiens
SQGLNLHTLLYLGGVEPSVPLSPATNMSAHFR

SEQ ID NO: 2254 - protein, 10 aa, Homo sapiens
GPTNNTCVVR

SEQ ID NO: 2255 - protein, 23 aa, Homo sapiens
HNNDTQHIWESDSNEFSVIADPR

SEQ ID NO: 2256 - protein, 16 aa, Homo sapiens
FGWDCHGLPVEYEIDK

SEQ ID NO: 2257 - protein, 16 aa, Homo sapiens
GLPSLTSVSWNISVPR

SEQ ID NO: 2258 - protein, 29 aa, Homo sapiens
TAGYGINILGMDPLSTPFDNEFYNGLCNR

SEQ ID NO: 2259 - protein, 16 aa, Homo sapiens
LQLSNGNMTLTLLSVK

SEQ ID NO: 2260 - protein, 19 aa, Homo sapiens
VGNVTAKDPEGLDISYSLR

SEQ ID NO: 2261 - protein, 23 aa, Homo sapiens
FQPSFLGMESCGIHETTFNSIMK

SEQ ID NO: 2262 - protein, 13 aa, Homo sapiens
FWLPHNVTWADLK

SEQ ID NO: 2263 - protein, 14 aa, Homo sapiens
YSNSALGHVNCTIK

SEQ ID NO: 2264 - protein, 10 aa, Homo sapiens
CVEDPETGLR

SEQ ID NO: 2265 - protein, 9 aa, Homo sapiens
ADGVTVTCK

SEQ ID NO: 2266 - protein, 11 aa, Homo sapiens
NAVWALSNLCR

SEQ ID NO: 2267 - protein, 28 aa, Homo sapiens
LLLSSETPIEGKNMSFVNDLTVTQDGRK

SEQ ID NO: 2268 - protein, 24 aa, Homo sapiens
GDLENAFLNLVQCIQNKPLYFADR

SEQ ID NO: 2269 - protein, 24 aa, Homo sapiens
LFDDWMASNGTQSLPTDVMTTVFK

SEQ ID NO: 2270 - protein, 21 aa, Homo sapiens
FTFTSHTPGEHQICLHSNSTK

SEQ ID NO: 2271 - protein, 21 aa, Homo sapiens
IVVNVSDTNDHAPWFTASSYK

SEQ ID NO: 2272 - protein, 22 aa, Homo sapiens
SLTQGSLIVGDLAPVNGTSQGK

SEQ ID NO: 2273 - protein, 19 aa, Homo sapiens
KPVTDCVISVPSFFTDAER

SEQ ID NO: 2274 - protein, 12 aa, Homo sapiens
KGCPPDDIENPR

SEQ ID NO: 2275 - protein, 10 aa, Homo sapiens
GSLSYLNVTR

SEQ ID NO: 2276 - protein, 20 aa, Homo sapiens
GNVNGTFIIHPDSGNLTVAR

SEQ ID NO: 2277 - protein, 11 aa, Homo sapiens
CQSLTEDLEFR

SEQ ID NO: 2278 - protein, 11 aa, Homo sapiens
CDENILWLDYK

SEQ ID NO: 2279 - protein, 11 aa, Homo sapiens
LLDIACWIHHK

SEQ ID NO: 2280 - protein, 14 aa, Homo sapiens
SINVTGQGFSLIQR

SEQ ID NO: 2281 - protein, 11 aa, Homo sapiens
SFYGSTLFLCR

SEQ ID NO: 2282 - protein, 9 aa, Homo sapiens
LHIVQVVCK

SEQ ID NO: 2283 - protein, 9 aa, Homo sapiens
CLIEILASR

SEQ ID NO: 2284 - protein, 16 aa, Homo sapiens
NMTFDLPSDATVVLNR

SEQ ID NO: 2285 - protein, 13 aa, Homo sapiens
MVVPLACLLTPLK

SEQ ID NO: 2286 - protein, 16 aa, Homo sapiens
EAGNHTSGAGLVQINK

SEQ ID NO: 2287 - protein, 13 aa, Homo sapiens
VIEEFYNQTWVHR

SEQ ID NO: 2288 - protein, 11 aa, Homo sapiens
CKIPALDLLIK

SEQ ID NO: 2289 - protein, 11 aa, Homo sapiens
WCVLSTPEIQK

SEQ ID NO: 2290 - protein, 8 aa, Homo sapiens
TIIFCETK

SEQ ID NO: 2291 - protein, 14 aa, Homo sapiens
VPGNVTAVLGETLK

SEQ ID NO: 2292 - protein, 15 aa, Homo sapiens
GSVAIWSGKPPICEK

SEQ ID NO: 2293 - protein, 9 aa, Homo sapiens
LTCFELAPK

SEQ ID NO: 2294 - protein, 14 aa, Homo sapiens
VDLEDFENNTAYAK

SEQ ID NO: 2295 - protein, 9 aa, Homo sapiens
EQQFNSTYR

SEQ ID NO: 2296 - protein, 11 aa, Homo sapiens
GGDEYDNHCGK

SEQ ID NO: 2297 - protein, 15 aa, Homo sapiens
YLPDTLLLEECGLLR

SEQ ID NO: 2298 - protein, 11 aa, Homo sapiens
VLEAVNGTDAR

SEQ ID NO: 2299 - protein, 15 aa, Homo sapiens
LSAVNSIFLSHNNTK

SEQ ID NO: 2300 - protein, 9 aa, Homo sapiens
QELLCAFWK

SEQ ID NO: 2301 - protein, 11 aa, Homo sapiens
AALQEELQLCK

SEQ ID NO: 2302 - protein, 10 aa, Homo sapiens
CNEIINWLDK

SEQ ID NO: 2303 - protein, 28 aa, Homo sapiens
EGSRTDDEVVQREEEAIQLDGLNASQIR

SEQ ID NO: 2304 - protein, 17 aa, Homo sapiens
LQQDVLQFQKNQTNLER

SEQ ID NO: 2305 - protein, 16 aa, Homo sapiens
IIKPCNHVLSLSFPIR

SEQ ID NO: 2306 - protein, 20 aa, Homo sapiens
TLGTPEFVTATECVHYFEWR

SEQ ID NO: 2307 - protein, 15 aa, Homo sapiens
LAFATMFNSSEQSQK

SEQ ID NO: 2308 - protein, 15 aa, Homo sapiens
YELSLHPNLTSMTFR

SEQ ID NO: 2309 - protein, 10 aa, Homo sapiens
SKFDNLYGCR

SEQ ID NO: 2310 - protein, 23 aa, Homo sapiens
LHVGYLQPLVAVQVSFAPNNTGK

SEQ ID NO: 2311 - protein, 13 aa, Homo sapiens
WCGTTQNYDADQK

SEQ ID NO: 2312 - protein, 7 aa, Homo sapiens
LLSAACR

SEQ ID NO: 2313 - protein, 16 aa, Homo sapiens
QEAKENGTNLTFIGDK

SEQ ID NO: 2314 - protein, 15 aa, Homo sapiens
FVGTPEVNQTTLYQR

SEQ ID NO: 2315 - protein, 15 aa, Homo sapiens
VACITEQVLTLVNKR

SEQ ID NO: 2316 - protein, 13 aa, Homo sapiens
FCTGLTQIETLFK

SEQ ID NO: 2317 - protein, 26 aa, Homo sapiens
MTVGEKVFSSNGQSITFDAIQEACAR

SEQ ID NO: 2318 - protein, 10 aa, Homo sapiens
YVQNGTYTVK

SEQ ID NO: 2319 - protein, 18 aa, Homo sapiens
GLNIALVNGTTGAVLGQK

SEQ ID NO: 2320 - protein, 17 aa, Homo sapiens
YTGTRPSNLANNTILVK

SEQ ID NO: 2321 - protein, 14 aa, Homo sapiens
CTVFHGAQVEDAFR

SEQ ID NO: 2322 - protein, 18 aa, Homo sapiens
ACLDYPVTSVLPPASLCK

SEQ ID NO: 2323 - protein, 26 aa, Homo sapiens
ITPNNNGTYACFVSNLATGRNNSIVK

SEQ ID NO: 2324 - protein, 9 aa, Homo sapiens
TVVALCGQR

SEQ ID NO: 2325 - protein, 9 aa, Homo sapiens
IIFANVSVR

SEQ ID NO: 2326 - protein, 27 aa, Homo sapiens
SHCIAEVENDEMPADLPSLAADFVESK

SEQ ID NO: 2327 - protein, 15 aa, Homo sapiens
IDCFSEVPTSVFGEK

SEQ ID NO: 2328 - protein, 11 aa, Homo sapiens
DIIACGFDINK

SEQ ID NO: 2329 - protein, 27 aa, Homo sapiens
ICISGDSAGGNLAAALGQQFTQDASLK

SEQ ID NO: 2330 - protein, 27 aa, Homo sapiens
EKDANVVVVDWLPLAHQLYTDAVNNTR

SEQ ID NO: 2331 - protein, 6 aa, Homo sapiens
CFFLSK

SEQ ID NO: 2332 - protein, 10 aa, Homo sapiens
FINYNQTVSR

SEQ ID NO: 2333 - protein, 20 aa, Homo sapiens
MLNTSSLLEQLNEQFNWVSR

SEQ ID NO: 2334 - protein, 9 aa, Homo sapiens
CNSLSTLEK

SEQ ID NO: 2335 - protein, 19 aa, Homo sapiens
YFDFLSSYSAVNQGHCHPK

SEQ ID NO: 2336 - protein, 15 aa, Homo sapiens
GYYNQSEAGSHILQR

SEQ ID NO: 2337 - protein, 25 aa, Homo sapiens
SDSVILNVLYGPDAPTISPLNTSYR

SEQ ID NO: 2338 - protein, 19 aa, Homo sapiens
TTLVDNNTWNNSHIALVGK

SEQ ID NO: 2339 - protein, 9 aa, Homo sapiens
VPLDVACAR

SEQ ID NO: 2340 - protein, 20 aa, Homo sapiens
LGQAPANWYNDTYPLSPPQR

SEQ ID NO: 2341 - protein, 14 aa, Homo sapiens
IAILTCPFEPPKPK

SEQ ID NO: 2342 - protein, 15 aa, Homo sapiens
QCRCMSVNLSDSDKQ

SEQ ID NO: 2343 - protein, 16 aa, Homo sapiens
NFEATLGWLQEHACSR

SEQ ID NO: 2344 - protein, 22 aa, Homo sapiens
TGGAYGEDLGADYNLSQVCDGK

SEQ ID NO: 2345 - protein, 19 aa, Homo sapiens
HNIIPIFAVTNYSYSYYEK

SEQ ID NO: 2346 - protein, 13 aa, Homo sapiens
LTDQLPLIIVCDR

SEQ ID NO: 2347 - protein, 23 aa, Homo sapiens
VTVPGNYYQLMCGLCGNYNGDPK

SEQ ID NO: 2348 - protein, 16 aa, Homo sapiens
RPPSAFFLFCSEYRPK

SEQ ID NO: 2349 - protein, 12 aa, Homo sapiens
LWNSTFLEEYSK

SEQ ID NO: 2350 - protein, 14 aa, Homo sapiens
CPFGGAFALAAGLR

SEQ ID NO: 2351 - protein, 11 aa, Homo sapiens
AVIFCLSADKK

SEQ ID NO: 2352 - protein, 11 aa, Homo sapiens
VGAPLVCCEIK

SEQ ID NO: 2353 - protein, 26 aa, Homo sapiens
RSDSVILNVLYGPDAPTISPLNTSYR

SEQ ID NO: 2354 - protein, 24 aa, Homo sapiens
LNCQVIGASVDSHFCHLAWVNTPK

SEQ ID NO: 2355 - protein, 12 aa, Homo sapiens
SPVTTLLECMHK

SEQ ID NO: 2356 - protein, 14 aa, Homo sapiens
LANLTQGEDQYYLR

SEQ ID NO: 2357 - protein, 21 aa, Homo sapiens
VWDTAVGLNHTAEPSLQTLER

SEQ ID NO: 2358 - protein, 17 aa, Homo sapiens
IAVQFGPGFSWIANFTK

SEQ ID NO: 2359 - protein, 18 aa, Homo sapiens
LNETHIFNGSNWIMLIYK

SEQ ID NO: 2360 - protein, 34 aa, Homo sapiens
VAEVWLDEYKELFYGHGDHLIDQGLDVGNLTQQR

SEQ ID NO: 2361 - protein, 29 aa, Homo sapiens
EGSTHNWQHITDQIGMFCFTGLKPEQVER

SEQ ID NO: 2362 - protein, 23 aa, Homo sapiens
LPNSTIYVVEPGYLGFTVHPGDR

SEQ ID NO: 2363 - protein, 10 aa, Homo sapiens
YNLSEVLQGK

SEQ ID NO: 2364 - protein, 19 aa, Homo sapiens
EACPELDYFVVFSSVSCGR

SEQ ID NO: 2365 - protein, 9 aa, Homo sapiens
CNELQDIEK

SEQ ID NO: 2366 - protein, 26 aa, Homo sapiens
TLTLFNVTRNDTASYKCETQNPVSAR

SEQ ID NO: 2367 - protein, 18 aa, Homo sapiens
FVFPFDYLPAEQLCIVAK

SEQ ID NO: 2368 - protein, 8 aa, Homo sapiens
NISQVLEK

SEQ ID NO: 2369 - protein, 14 aa, Homo sapiens
SCYLSSLDLLLEHR

SEQ ID NO: 2370 - protein, 38 aa, Homo sapiens
TILPAAAQDVYYRDEIGNVSTSHLLILDDSVEMEIRPR

SEQ ID NO: 2371 - protein, 22 aa, Homo sapiens
SLGSGGSVSQLFSNFTGSVDDR

SEQ ID NO: 2372 - protein, 19 aa, Homo sapiens
LPVVIGGLLDVDCSEDVIK

SEQ ID NO: 2373 - protein, 14 aa, Homo sapiens
GHYNNVSCAVFHPR

SEQ ID NO: 2374 - protein, 11 aa, Homo sapiens
GLSSLLCNFTK

SEQ ID NO: 2375 - protein, 9 aa, Homo sapiens
TCFETFPDK

SEQ ID NO: 2376 - protein, 13 aa, Homo sapiens
SLCLGPALIHTAK

SEQ ID NO: 2377 - protein, 12 aa, Homo sapiens
AYLEGTCVEWLR

SEQ ID NO: 2378 - protein, 15 aa, Homo sapiens
LLLCGGAPLSATTQR

SEQ ID NO: 2379 - protein, 17 aa, Homo sapiens
VNCETSCVQQPPCFPLK

SEQ ID NO: 2380 - protein, 22 aa, Homo sapiens
DGTVLCELINALYPEGQAPVKK

SEQ ID NO: 2381 - protein, 25 aa, Homo sapiens
SINTEVVACSVDSQFTHLAWINTPR

SEQ ID NO: 2382 - protein, 11 aa, Homo sapiens
CIPPSYADLGK

SEQ ID NO: 2383 - protein, 12 aa, Homo sapiens
YICENQDSISSK

SEQ ID NO: 2384 - protein, 15 aa, Homo sapiens
LNPTVTYGNDSFSAK

SEQ ID NO: 2385 - protein, 10 aa, Homo sapiens
TSAVPSPCGK

SEQ ID NO: 2386 - protein, 13 aa, Homo sapiens
NNDLCYWVPELVR

SEQ ID NO: 2387 - protein, 15 aa, Homo sapiens
DLGPTLANSTHHNVR

SEQ ID NO: 2388 - protein, 31 aa, Homo sapiens
RGDDLYTNVTISLVESLVGFEMDITHLDGHK

SEQ ID NO: 2389 - protein, 17 aa, Homo sapiens
YTCHVQHEGLPKPLTLR

SEQ ID NO: 2390 - protein, 14 aa, Homo sapiens
VACITEQVLTLVNK

SEQ ID NO: 2391 - protein, 19 aa, Homo sapiens
VFIMDNCEELIPEYLNFIR

SEQ ID NO: 2392 - protein, 18 aa, Homo sapiens
APKPVEMVENSTDPHPIK

SEQ ID NO: 2393 - protein, 26 aa, Homo sapiens
ILASLDFAQNFITNNTSSVIIEETKK

SEQ ID NO: 2394 - protein, 24 aa, Homo sapiens
TDDEVVQREEEAIQLDGLNASQIR

SEQ ID NO: 2395 - protein, 28 aa, Homo sapiens
VPSENKDLYEYSWVQGPLHSNETDRLPR

SEQ ID NO: 2396 - protein, 24 aa, Homo sapiens
YSVQLMSFVYNLSDTHLFPNASSK

SEQ ID NO: 2397 - protein, 7 aa, Homo sapiens
CALGVFR

SEQ ID NO: 2398 - protein, 28 aa, Homo sapiens
VAEAVSSPAGVGVTWLEPDYQVYLNASK

SEQ ID NO: 2399 - protein, 9 aa, Homo sapiens
TLTLFNVTR

SEQ ID NO: 2400 - protein, 28 aa, Homo sapiens
ETIYPNGTLLIQNVTHNDAGIYTLHVIK

SEQ ID NO: 2401 - protein, 6 aa, Homo sapiens
SPFLCR

SEQ ID NO: 2402 - protein, 20 aa, Homo sapiens
ANLSQVADHLDHIKEVAGAR

SEQ ID NO: 2403 - protein, 20 aa, Homo sapiens
NLALCPANHAPLQEAAVIPR

SEQ ID NO: 2404 - protein, 10 aa, Homo sapiens
CPFTGNVSIR

SEQ ID NO: 2405 - protein, 23 aa, Homo sapiens
CKDDEFTHLYTLIVRPDNTYEVK

SEQ ID NO: 2406 - protein, 14 aa, Homo sapiens
VDIQTEDLEDGTCK

SEQ ID NO: 2407 - protein, 10 aa, Homo sapiens
ASCLYGQLPK

SEQ ID NO: 2408 - protein, 11 aa, Homo sapiens
DNSTLAVDIYK

SEQ ID NO: 2409 - protein, 9 aa, Homo sapiens
CATITPDEK

SEQ ID NO: 2410 - protein, 14 aa, Homo sapiens
SRLWNSTFLEEYSK

SEQ ID NO: 2411 - protein, 8 aa, Homo sapiens
FCPEADSK

SEQ ID NO: 2412 - protein, 18 aa, Homo sapiens
QDTPQYNLTIEVSDKDFK

SEQ ID NO: 2413 - protein, 21 aa, Homo sapiens
IAPNTPQLADIVATGFSVCGR

SEQ ID NO: 2414 - protein, 17 aa, Homo sapiens
LQLSNDNRTLTLLSVTR

SEQ ID NO: 2415 - protein, 9 aa, Homo sapiens
GCILTLVER

SEQ ID NO: 2416 - protein, 16 aa, Homo sapiens
YLEGTSCIAGVLVPAK

SEQ ID NO: 2417 - protein, 22 aa, Homo sapiens
VDLGTLRGYYNQSEAGSHTVQR

SEQ ID NO: 2418 - protein, 14 aa, Homo sapiens
ELGSECGIEFDEEK

SEQ ID NO: 2419 - protein, 16 aa, Homo sapiens
AIPTIVSDGNTTFQEK

SEQ ID NO: 2420 - protein, 31 aa, Homo sapiens
IGPALSCGNTVVVKPAEQTPLTALHVASLIK

SEQ ID NO: 2421 - protein, 19 aa, Homo sapiens
VASVININPNTTHSTGSCR

SEQ ID NO: 2422 - protein, 19 aa, Homo sapiens
IWCFGPDGTGPNILTDITK

SEQ ID NO: 2423 - protein, 16 aa, Homo sapiens
WLFGGGTKVTVLGQPK

SEQ ID NO: 2424 - protein, 22 aa, Homo sapiens
VTQNLTLIEESLTSEFIHDIDR

SEQ ID NO: 2425 - protein, 14 aa, Homo sapiens
ELGDNVSMILVPFK

SEQ ID NO: 2426 - protein, 13 aa, Homo sapiens
LNWTSLLPASFTK

SEQ ID NO: 2427 - protein, 19 aa, Homo sapiens
TALWVATDHNMDNTSTVLR

SEQ ID NO: 2428 - protein, 28 aa, Homo sapiens
EIIYPNASLLIQNIIQNDTGFYTLHVIK

SEQ ID NO: 2429 - protein, 15 aa, Homo sapiens
INATDADEPNTLNSK

SEQ ID NO: 2430 - protein, 15 aa, Homo sapiens
VQWEKNTTSVWYTSK

SEQ ID NO: 2431 - protein, 19 aa, Homo sapiens
VANLTEPVVLTFQHQLQPK

SEQ ID NO: 2432 - protein, 8 aa, Homo sapiens
IISANGCK

SEQ ID NO: 2433 - protein, 17 aa, Homo sapiens
LGLLCQTVSQVVNAKEK

SEQ ID NO: 2434 - protein, 11 aa, Homo sapiens
DAGVVCTNETR

SEQ ID NO: 2435 - protein, 25 aa, Homo sapiens
GTEVNTTVIGENDPIDEVQGFLFGK

SEQ ID NO: 2436 - protein, 22 aa, Homo sapiens
TMVFPVMYLNESVHIDKETASR

SEQ ID NO: 2437 - protein, 16 aa, Homo sapiens
AAGGAVCEQPLGLECR

SEQ ID NO: 2438 - protein, 28 aa, Homo sapiens
TTPPSVYPLAPGSAAQTNSMVTLGCLVK

SEQ ID NO: 2439 - protein, 18 aa, Homo sapiens
VAHALAEGLGVIACIGEK

SEQ ID NO: 2440 - protein, 19 aa, Homo sapiens
LLEAQACTGGIIDPSTGER

SEQ ID NO: 2441 - protein, 8 aa, Homo sapiens
LSIQCYLR

SEQ ID NO: 2442 - protein, 8 aa, Homo sapiens
VCLDIIYK

SEQ ID NO: 2443 - protein, 20 aa, Homo sapiens
CMALAQLLVEQNFPAIAIHR

SEQ ID NO: 2444 - protein, 11 aa, Homo sapiens
GCPPDDIENPR

SEQ ID NO: 2445 - protein, 9 aa, Homo sapiens
FNGSVSFFR

SEQ ID NO: 2446 - protein, 10 aa, Homo sapiens
LFQNCSELFK

SEQ ID NO: 2447 - protein, 16 aa, Homo sapiens
LSALDNLLNHSSMFLK

SEQ ID NO: 2448 - protein, 20 aa, Homo sapiens
SGPKNMTFDLPSDATVVLNR

SEQ ID NO: 2449 - protein, 16 aa, Homo sapiens
TLTLFNVTRNDTASYK

SEQ ID NO: 2450 - protein, 9 aa, Homo sapiens
WSTAVEFCK

SEQ ID NO: 2451 - protein, 7 aa, Homo sapiens
FIVCLNK

SEQ ID NO: 2452 - protein, 29 aa, Homo sapiens
DSGIWINGFDYTGISHITPHIPEINDSIR

SEQ ID NO: 2453 - protein, 15 aa, Homo sapiens
ENATVPENEEEIIRK

SEQ ID NO: 2454 - protein, 18 aa, Homo sapiens
ANIQFGDNGTTISAVSNK

SEQ ID NO: 2455 - protein, 25 aa, Homo sapiens
GVLTNPNCEFEANYVAIHTLATWYK

SEQ ID NO: 2456 - protein, 23 aa, Homo sapiens
ITAQSIEELCAVNLYGPDAQVDR

SEQ ID NO: 2457 - protein, 27 aa, Homo sapiens
EVKGDLENAFLNLVQCIQNKPLYFADR

SEQ ID NO: 2458 - protein, 19 aa, Homo sapiens
NVGCLQEALQLATSFAQLR

SEQ ID NO: 2459 - protein, 34 aa, Homo sapiens
IQNILSEKPTVTTVYANNGSVLQGSSVASVYDGK

SEQ ID NO: 2460 - protein, 21 aa, Homo sapiens
VLGFKPKPPKNESLETYPVMK

SEQ ID NO: 2461 - protein, 17 aa, Homo sapiens
CPFGALSIVNLPSNLEK

SEQ ID NO: 2462 - protein, 17 aa, Homo sapiens
IAPASNVSHTVVLRPLK

SEQ ID NO: 2463 - protein, 10 aa, Homo sapiens
TFYSCTTEGR

SEQ ID NO: 2464 - protein, 17 aa, Homo sapiens
QAAPCVLFFDELDSIAK

SEQ ID NO: 2465 - protein, 8 aa, Homo sapiens
GIFPVLCK

SEQ ID NO: 2466 - protein, 16 aa, Homo sapiens
LSLDGQNIYNACCTLR

SEQ ID NO: 2467 - protein, 33 aa, Homo sapiens
VVRPDSELGERPPEDNQSFQYDHEAFLGKEDSK

SEQ ID NO: 2468 - protein, 20 aa, Homo sapiens
VHSPSGALEECYVTEIDQDK

SEQ ID NO: 2469 - protein, 16 aa, Homo sapiens
DIPFSAIYFPCYAHVK

SEQ ID NO: 2470 - protein, 19 aa, Homo sapiens
TPEVTCVVVDVSHEDPQVK

SEQ ID NO: 2471 - protein, 35 aa, Homo sapiens
LADDVDLEQVANETHGHVGADLAALCSEAALQAIR

SEQ ID NO: 2472 - protein, 24 aa, Homo sapiens
FIQENIFGICPHMTEDNKDLIQGK

SEQ ID NO: 2473 - protein, 15 aa, Homo sapiens
ARLNWTSLLPASFTK

SEQ ID NO: 2474 - protein, 13 aa, Homo sapiens
DLSYCLSGMYDHR

SEQ ID NO: 2475 - protein, 17 aa, Homo sapiens
SLGTIQQCCDAIDHLCR

SEQ ID NO: 2476 - protein, 22 aa, Homo sapiens
TPQICVVGSGPAGFYTAQHLLK

SEQ ID NO: 2477 - protein, 19 aa, Homo sapiens
YSDESGNMDFDNFISCLVR

SEQ ID NO: 2478 - protein, 19 aa, Homo sapiens
CVFELPAENDKPHDVEINK

SEQ ID NO: 2479 - protein, 18 aa, Homo sapiens
LLLAGYDDFNCNVWDALK

SEQ ID NO: 2480 - protein, 18 aa, Homo sapiens
VINETWAWKNATLAEQAK

SEQ ID NO: 2481 - protein, 13 aa, Homo sapiens
HEQNIDCGGGYVK

SEQ ID NO: 2482 - protein, 16 aa, Homo sapiens
VLQEALCVISGVPGLK

SEQ ID NO: 2483 - protein, 19 aa, Homo sapiens
LDLPNRPETSFLWFTNPCK

SEQ ID NO: 2484 - protein, 22 aa, Homo sapiens
LSLLEEPGNGTFTVILNQLTSR

SEQ ID NO: 2485 - protein, 7 aa, Homo sapiens
LISLICR

SEQ ID NO: 2486 - protein, 17 aa, Homo sapiens
IEGDMIVCAAYAHELPK

SEQ ID NO: 2487 - protein, 15 aa, Homo sapiens
NTCQLYIQTDHLFFK

SEQ ID NO: 2488 - protein, 11 aa, Homo sapiens
AKGETAYLPCK

SEQ ID NO: 2489 - protein, 7 aa, Homo sapiens
IFQALCK

SEQ ID NO: 2490 - protein, 11 aa, Homo sapiens
AAGPLLTDECR

SEQ ID NO: 2491 - protein, 19 aa, Homo sapiens
GVTIIGPATVGGIKPGCFK

SEQ ID NO: 2492 - protein, 17 aa, Homo sapiens
IVQIPFCGEIDCEDWIK

SEQ ID NO: 2493 - protein, 14 aa, Homo sapiens
AGPNGTLFVADAYK

SEQ ID NO: 2494 - protein, 21 aa, Homo sapiens
GITNLCVIGGDGSLTGANLFR

SEQ ID NO: 2495 - protein, 6 aa, Homo sapiens
TDSTCR

SEQ ID NO: 2496 - protein, 13 aa, Homo sapiens
GIFGFTDSDCIGK

SEQ ID NO: 2497 - protein, 14 aa, Homo sapiens
LQCYNCPNPTADCK

SEQ ID NO: 2498 - protein, 12 aa, Homo sapiens
LVQLFPNDTSLK

SEQ ID NO: 2499 - protein, 17 aa, Homo sapiens
CFIEEIPDETMVIGNYR

SEQ ID NO: 2500 - protein, 25 aa, Homo sapiens
SNWEAGNTFTCSVLHEGLHNHHTEK

SEQ ID NO: 2501 - protein, 20 aa, Homo sapiens
LQDERANLTTLAGTHTNIPK

SEQ ID NO: 2502 - protein, 12 aa, Homo sapiens
NILPNITTTYLK

SEQ ID NO: 2503 - protein, 28 aa, Homo sapiens
GPHFTFSLGSGSLQNDWEVSKINGTHAR

SEQ ID NO: 2504 - protein, 12 aa, Homo sapiens
ELYNGTADITLR

SEQ ID NO: 2505 - protein, 10 aa, Homo sapiens
SAEFFNYTVR

SEQ ID NO: 2506 - protein, 13 aa, Homo sapiens
LNNISIIGPLDMK

SEQ ID NO: 2507 - protein, 17 aa, Homo sapiens
HLNEIDLFHCIDPNDSK

SEQ ID NO: 2508 - protein, 18 aa, Homo sapiens
GCVLDVCMGGGDHDILCK

SEQ ID NO: 2509 - protein, 16 aa, Homo sapiens
CFNTLTNSFQPSLLGR

SEQ ID NO: 2510 - protein, 9 aa, Homo sapiens
VINETWAWK

SEQ ID NO: 2511 - protein, 9 aa, Homo sapiens
LPSCSADPR

SEQ ID NO: 2512 - protein, 21 aa, Homo sapiens
IYSNHSALESLALIPLQAPLK

SEQ ID NO: 2513 - protein, 20 aa, Homo sapiens
VFPYISVMVNNGSLSYDHSK

SEQ ID NO: 2514 - protein, 8 aa, Homo sapiens
YCAGWADK

SEQ ID NO: 2515 - protein, 8 aa, Homo sapiens
EMVECFNK

SEQ ID NO: 2516 - protein, 15 aa, Homo sapiens
SFDDHFQHLLNDSER

SEQ ID NO: 2517 - protein, 15 aa, Homo sapiens
NVTHLLQQELTEAQK

SEQ ID NO: 2518 - protein, 11 aa, Homo sapiens
IVDVNLTSEGK

SEQ ID NO: 2519 - protein, 23 aa, Homo sapiens
ADDKFVNVTIVTILAETTSDNEK

SEQ ID NO: 2520 - protein, 20 aa, Homo sapiens
ITQAVLGAHDGGVFGLCALR

SEQ ID NO: 2521 - protein, 18 aa, Homo sapiens
LWLPVNLTWADLEDRDGR

SEQ ID NO: 2522 - protein, 22 aa, Homo sapiens
FSVICPAVLQQLNFHPCEDRPK

SEQ ID NO: 2523 - protein, 8 aa, Homo sapiens
LTDCVVMR

SEQ ID NO: 2524 - protein, 35 aa, Homo sapiens
LGVHPLSCHGWVLGEHGDSSVPVWSGMNVAGVSLK

SEQ ID NO: 2525 - protein, 16 aa, Homo sapiens
TILVDNNTWNNTHISR

SEQ ID NO: 2526 - protein, 9 aa, Homo sapiens
GSDFDCELR

SEQ ID NO: 2527 - protein, 17 aa, Homo sapiens
LQLSNGNMTLTLLSVKR

SEQ ID NO: 2528 - protein, 14 aa, Homo sapiens
VDKDCAYCTDEMFR

SEQ ID NO: 2529 - protein, 17 aa, Homo sapiens
LIEGLSHEVIVSAACGR

SEQ ID NO: 2530 - protein, 14 aa, Homo sapiens
FTPYVGPIIPCILK

SEQ ID NO: 2531 - protein, 19 aa, Homo sapiens
SSCGKENTSDPSLVIAFGR

SEQ ID NO: 2532 - protein, 13 aa, Homo sapiens
VIECSYTSADGQR

SEQ ID NO: 2533 - protein, 30 aa, Homo sapiens
DCFIIYQGHHGDVGAPIADVILPGAAYTEK

SEQ ID NO: 2534 - protein, 35 aa, Homo sapiens
GHEVEDVDLELFNTSVQLQPPTTAPGPETAAFIER

SEQ ID NO: 2535 - protein, 23 aa, Homo sapiens
LPIQDILSAFSVYVNNTESYIHR

SEQ ID NO: 2536 - protein, 17 aa, Homo sapiens
LQLSNGNRTLTLFNVTR

SEQ ID NO: 2537 - protein, 10 aa, Homo sapiens
EGVVECSFVK

SEQ ID NO: 2538 - protein, 8 aa, Homo sapiens
AQCPIVER

SEQ ID NO: 2539 - protein, 13 aa, Homo sapiens
KQNNGAFNETLFR

SEQ ID NO: 2540 - protein, 10 aa, Homo sapiens
YHVLHINTTK

SEQ ID NO: 2541 - protein, 18 aa, Homo sapiens
DAVRNLTEVVPQLLDQLR

SEQ ID NO: 2542 - protein, 21 aa, Homo sapiens
DGTVLCELINALYPEGQAPVK

SEQ ID NO: 2543 - protein, 25 aa, Homo sapiens
GLPFTATAEEVVAFFGQHCPITGGK

SEQ ID NO: 2544 - protein, 14 aa, Homo sapiens
MIENGSLSFLPTLR

SEQ ID NO: 2545 - protein, 20 aa, Homo sapiens
YLQPLLAVQFTNLTMDTEIR

SEQ ID NO: 2546 - protein, 20 aa, Homo sapiens
FKLEWLGNCSGLNDETYGYK

SEQ ID NO: 2547 - protein, 18 aa, Homo sapiens
IQCSVSALNQGQVWIGGR

SEQ ID NO: 2548 - protein, 35 aa, Homo sapiens
IAENYTAVVSPDIASIDLNTFEFNKPSPYGSNHNR

SEQ ID NO: 2549 - protein, 11 aa, Homo sapiens
LECGGGPWGNK

SEQ ID NO: 2550 - protein, 14 aa, Homo sapiens
HMAAASAECQNYAK

SEQ ID NO: 2551 - protein, 11 aa, Homo sapiens
YLLDSCAPLLR

SEQ ID NO: 2552 - protein, 13 aa, Homo sapiens
KVEELQACVETAR

SEQ ID NO: 2553 - protein, 13 aa, Homo sapiens
HMNLILCDCDEFR

SEQ ID NO: 2554 - protein, 13 aa, Homo sapiens
SLLINAVEASCIR

SEQ ID NO: 2555 - protein, 14 aa, Homo sapiens
CITDTLQELVNQSK

SEQ ID NO: 2556 - protein, 18 aa, Homo sapiens
RPTEICADPQFIIGGATR

SEQ ID NO: 2557 - protein, 15 aa, Homo sapiens
TFVDFFSQCLHEEYR

SEQ ID NO: 2558 - protein, 13 aa, Homo sapiens
IEEFLEEVLCPPK

SEQ ID NO: 2559 - protein, 15 aa, Homo sapiens
LPFCAMGVSSVIHPK

SEQ ID NO: 2560 - protein, 10 aa, Homo sapiens
LSSFDPCFYR

SEQ ID NO: 2561 - protein, 10 aa, Homo sapiens
HANWTLTPLK

SEQ ID NO: 2562 - protein, 40 aa, Homo sapiens
SYLGDGPLQHYIAVSSPTNTTYVVQYALANLTGTVVNLTR

SEQ ID NO: 2563 - protein, 14 aa, Homo sapiens
IECDDKGDGSCDVR

SEQ ID NO: 2564 - protein, 17 aa, Homo sapiens
AIVDCIISIIEENSESK

SEQ ID NO: 2565 - protein, 18 aa, Homo sapiens
ELLNPVVEFVSHPSTTCR

SEQ ID NO: 2566 - protein, 17 aa, Homo sapiens
YYGGAEVVDEIELLCQR

SEQ ID NO: 2567 - protein, 10 aa, Homo sapiens
VTCVVVDISK

SEQ ID NO: 2568 - protein, 22 aa, Homo sapiens
TETGQELECLQDHLDDLVVECR

SEQ ID NO: 2569 - protein, 16 aa, Homo sapiens
STSSFPCPAGHFNGFR

SEQ ID NO: 2570 - protein, 23 aa, Homo sapiens
FITSILYENNVITIDLVQNSSQK

SEQ ID NO: 2571 - protein, 12 aa, Homo sapiens
KWGHNITEFQQR

SEQ ID NO: 2572 - protein, 11 aa, Homo sapiens
QTLQNASETVK

SEQ ID NO: 2573 - protein, 14 aa, Homo sapiens
DMSDGFISNLTIQR

SEQ ID NO: 2574 - protein, 16 aa, Homo sapiens
TLNSSGLPFGSYTFEK

SEQ ID NO: 2575 - protein, 11 aa, Homo sapiens
MYACDVGPDGR

SEQ ID NO: 2576 - protein, 19 aa, Homo sapiens
EEFCGLLSSPTGPLSSCHK

SEQ ID NO: 2577 - protein, 16 aa, Homo sapiens
GVGTDEACLIEILASR

SEQ ID NO: 2578 - protein, 16 aa, Homo sapiens
AINEFYLKSSDLEQLR

SEQ ID NO: 2579 - protein, 13 aa, Homo sapiens
FIITALPTIYHCK

SEQ ID NO: 2580 - protein, 18 aa, Homo sapiens
NSGLYTCQANNSASGHSR

SEQ ID NO: 2581 - protein, 14 aa, Homo sapiens
ANLSQVADHLDHIK

SEQ ID NO: 2582 - protein, 13 aa, Homo sapiens
WFFKNQSLPSSER

SEQ ID NO: 2583 - protein, 18 aa, Homo sapiens
ILLDQVEEAVADFDECIR

SEQ ID NO: 2584 - protein, 13 aa, Homo sapiens
ICLEDNVLMSGVK

SEQ ID NO: 2585 - protein, 11 aa, Homo sapiens
NMSVHLSPCFR

SEQ ID NO: 2586 - protein, 13 aa, Homo sapiens
NILEESLCELVAK

SEQ ID NO: 2587 - protein, 15 aa, Homo sapiens
SASLCAATLAAVLQR

SEQ ID NO: 2588 - protein, 13 aa, Homo sapiens
AALEALGSCLNNK

SEQ ID NO: 2589 - protein, 18 aa, Homo sapiens
FIQENIFGICPHMTEDNK

SEQ ID NO: 2590 - protein, 23 aa, Homo sapiens
IETVLPAEFFEVLSSSQNGSYHR

SEQ ID NO: 2591 - protein, 19 aa, Homo sapiens
KQDTPQYNLTIEVSDKDFK

SEQ ID NO: 2592 - protein, 12 aa, Homo sapiens
VDCTANTNTCNK

SEQ ID NO: 2593 - protein, 16 aa, Homo sapiens
NMSFVNDLTVTQDGRK

SEQ ID NO: 2594 - protein, 26 aa, Homo sapiens
GVVTDEQGIPIANATISVSGINHGVK

SEQ ID NO: 2595 - protein, 10 aa, Homo sapiens
NIYYLCAPNR

SEQ ID NO: 2596 - protein, 12 aa, Homo sapiens
FICEQDHQNFLR

SEQ ID NO: 2597 - protein, 13 aa, Homo sapiens
SQFEELCAELLQK

SEQ ID NO: 2598 - protein, 21 aa, Homo sapiens
LVSSPCCIVTSTYGWTANMER

SEQ ID NO: 2599 - protein, 38 aa, Homo sapiens
AGYFNFTSATITYLAQEDGPVVIGSTSAPGQGGILAQR

SEQ ID NO: 2600 - protein, 13 aa, Homo sapiens
QNCELFEQLGEYK

SEQ ID NO: 2601 - protein, 11 aa, Homo sapiens
YCAQDAFFQVK

SEQ ID NO: 2602 - protein, 13 aa, Homo sapiens
TIVYLDGSSQSCR

SEQ ID NO: 2603 - protein, 14 aa, Homo sapiens
LEEEQIILEDQNCK

SEQ ID NO: 2604 - protein, 12 aa, Homo sapiens
QNNGAFNETLFR

SEQ ID NO: 2605 - protein, 14 aa, Homo sapiens
VLFLLGADGGCITR

SEQ ID NO: 2606 - protein, 15 aa, Homo sapiens
LRPNFLAVCDPDWSR

SEQ ID NO: 2607 - protein, 9 aa, Homo sapiens
CIQTPPFLR

SEQ ID NO: 2608 - protein, 14 aa, Homo sapiens
GDSIDQCALIQSIK

SEQ ID NO: 2609 - protein, 14 aa, Homo sapiens
YSFCTDHTVLVQTR

SEQ ID NO: 2610 - protein, 11 aa, Homo sapiens
KPVVGQCTIER

SEQ ID NO: 2611 - protein, 15 aa, Homo sapiens
VWNSTFIEDYRDFDR

SEQ ID NO: 2612 - protein, 17 aa, Homo sapiens
LQGEGLSVAGIVCHVGK

SEQ ID NO: 2613 - protein, 21 aa, Homo sapiens
FNPNISWQPIPVHTVPITEDR

SEQ ID NO: 2614 - protein, 26 aa, Homo sapiens
ANLTNFPENGTFVVNIAQLSQDDSGR

SEQ ID NO: 2615 - protein, 13 aa, Homo sapiens
TVLENSTSYEEAK

SEQ ID NO: 2616 - protein, 12 aa, Homo sapiens
NCPHVVVGTPGR

SEQ ID NO: 2617 - protein, 25 aa, Homo sapiens
DVVTAAGDMLKDNATEEEILVYLEK

SEQ ID NO: 2618 - protein, 17 aa, Homo sapiens
NLEKNSTKQEILAALEK

SEQ ID NO: 2619 - protein, 13 aa, Homo sapiens
NCEPMIGLVPILK

SEQ ID NO: 2620 - protein, 25 aa, Homo sapiens
YPQDYQFYIQNFTALPLNTVVPPQR

SEQ ID NO: 2621 - protein, 22 aa, Homo sapiens
LCPGGQLPFLLYGTEVHTDTNK

SEQ ID NO: 2622 - protein, 12 aa, Homo sapiens
LSIPTYGLQCTR

SEQ ID NO: 2623 - protein, 11 aa, Homo sapiens
WTFSAQNASLR

SEQ ID NO: 2624 - protein, 28 aa, Homo sapiens
CPEALFQPSFLGMESCGIHETTFNSIMK

SEQ ID NO: 2625 - protein, 14 aa, Homo sapiens
LLQVVYLHSNNITK

SEQ ID NO: 2626 - protein, 20 aa, Homo sapiens
WVDPNSPVLLEDPVLCALAK

SEQ ID NO: 2627 - protein, 15 aa, Homo sapiens
DYYPINESLASLPLR

SEQ ID NO: 2628 - protein, 6 aa, Homo sapiens
AAPECK

SEQ ID NO: 2629 - protein, 11 aa, Homo sapiens
WGHNITEFQQR

SEQ ID NO: 2630 - protein, 14 aa, Homo sapiens
ACLISLGYDVENDR

SEQ ID NO: 2631 - protein, 17 aa, Homo sapiens
ACANPAAGSVILLENLR

SEQ ID NO: 2632 - protein, 19 aa, Homo sapiens
SDLQRPNPQSPFCVASSLK

SEQ ID NO: 2633 - protein, 9 aa, Homo sapiens
NCLALADDK

SEQ ID NO: 2634 - protein, 18 aa, Homo sapiens
LCEAICPAQAITIEAEPR

SEQ ID NO: 2635 - protein, 9 aa, Homo sapiens
ECPSVLEYK

SEQ ID NO: 2636 - protein, 14 aa, Homo sapiens
SLHDALCVLAQTVK

SEQ ID NO: 2637 - protein, 13 aa, Homo sapiens
HECQANGPEDLNR

SEQ ID NO: 2638 - protein, 12 aa, Homo sapiens
TIIPLISQCTPK

SEQ ID NO: 2639 - DNA, 31 bp, Artificial Sequence
  Primer
ggggacaagtttgtacaaaaaagcaggcttc

SEQ ID NO: 2640 - DNA, 29 bp, Artificial Sequence
  Primer
ggggaccactttgtacaagaaagctgggt
